United States Patent 8,362,230 (NUCLEIC ACID MOLECULES AND COLLECTIONS THEREOF, THEIR APPLICATION AND MODIFICATION) - sequence listing, part 2

SEQ ID NO: 11997 - DNA, 22 bp, Artificial
  MQbrain_837; macaque brain D708ZXV01D74YN sequence
gagccttgggctggtgtgagct

SEQ ID NO: 11998 - DNA, 21 bp, Artificial
  MQbrain_83; macaque brain D708ZXV02I160L sequence
gggatggtcgcggagagtcgg

SEQ ID NO: 11999 - DNA, 19 bp, Artificial
  MQbrain_840; macaque brain D708YRU02ILA56 sequence
aaggagggtggtcctttgg

SEQ ID NO: 12000 - DNA, 23 bp, Artificial
  MQbrain_841; macaque brain D4HK8WR01ELI6Q sequence
gctagagagttaggggccttagg

SEQ ID NO: 12001 - DNA, 20 bp, Artificial
  MQbrain_843; macaque brain D4HK8WR01D9O1F sequence
gtacgcagcctccagttctc

SEQ ID NO: 12002 - DNA, 19 bp, Artificial
  MQbrain_844; macaque brain D4HK8WR01BINZP sequence
aagccttcgtcctagtgtg

SEQ ID NO: 12003 - DNA, 18 bp, Artificial
  MQbrain_845; macaque brain D708I2V01CEGDG sequence
gagcaagaggagagcagt

SEQ ID NO: 12004 - DNA, 25 bp, Artificial
  MQbrain_846; macaque brain D708I2V02I0LOI sequence
gaggtgcacttggagagacttaatg

SEQ ID NO: 12005 - DNA, 21 bp, Artificial
  MQbrain_847; macaque brain D4HK8WR02G85N4 sequence
atgtgtgacaatgttgtatcc

SEQ ID NO: 12006 - DNA, 20 bp, Artificial
  MQbrain_848; macaque brain D4HK8WR02IUBB0 sequence
aaagcttccactcttcagtc

SEQ ID NO: 12007 - DNA, 20 bp, Artificial
  MQbrain_849; macaque brain D708ZXV01CCGZ6 sequence
agtgccaggaggaggagctc

SEQ ID NO: 12008 - DNA, 18 bp, Artificial
  MQbrain_84; macaque brain D708YRU02GHQYT sequence
ctgggctgggtgggtttt

SEQ ID NO: 12009 - DNA, 22 bp, Artificial
  MQbrain_850; macaque brain D4HK4YF02I8XOK sequence
gaagtgaaggagagagactcgg

SEQ ID NO: 12010 - DNA, 18 bp, Artificial
  MQbrain_851; macaque brain D708ZXV01E0VF7 sequence
aattgcttgtgaggtggg

SEQ ID NO: 12011 - DNA, 19 bp, Artificial
  MQbrain_852; macaque brain D4HK8WR02J3RGE sequence
aagatggcggatctggagg

SEQ ID NO: 12012 - DNA, 19 bp, Artificial
  MQbrain_854; macaque brain D708I2V02F4Q6T sequence
gtgagttgtggctgcttcg

SEQ ID NO: 12013 - DNA, 18 bp, Artificial
  MQbrain_855; macaque brain D708I2V01AKCU3 sequence
tggctgacggcaggttgt

SEQ ID NO: 12014 - DNA, 18 bp, Artificial
  MQbrain_857; macaque brain D4G3X1F02HS7TH sequence
ggagagtgtagggagact

SEQ ID NO: 12015 - DNA, 20 bp, Artificial
  MQbrain_858; macaque brain D708I2V01DM8IO sequence
gaggaggaagagaagggtcc

SEQ ID NO: 12016 - DNA, 22 bp, Artificial
  MQbrain_859; macaque brain D4G3X1F02HDWPL sequence
cttccatggcctgagctccctc

SEQ ID NO: 12017 - DNA, 18 bp, Artificial
  MQbrain_85; macaque brain D4HK8WR02JI3ZN sequence
gggatgcctgggcttttc

SEQ ID NO: 12018 - DNA, 19 bp, Artificial
  MQbrain_860; macaque brain D708I2V01D5PIX sequence
gatggggagaggctgatgt

SEQ ID NO: 12019 - DNA, 21 bp, Artificial
  MQbrain_861; macaque brain D708I2V01BZLAY sequence
agccctaggaatccgtcagtg

SEQ ID NO: 12020 - DNA, 21 bp, Artificial
  MQbrain_862; macaque brain D708YRU02G7VA4 sequence
gggtgtctgggtctgctcagg

SEQ ID NO: 12021 - DNA, 21 bp, Artificial
  MQbrain_863; macaque brain D4HK8WR01C7NZW sequence
tggtgtgggaagggtgtcctg

SEQ ID NO: 12022 - DNA, 23 bp, Artificial
  MQbrain_864; macaque brain D708ZXV02G0SZ8 sequence
gatggaggccagcagtctaagtt

SEQ ID NO: 12023 - DNA, 19 bp, Artificial
  MQbrain_866; macaque brain D708ZXV02G65RB sequence
agatgttgtgcagttgtgg

SEQ ID NO: 12024 - DNA, 19 bp, Artificial
  MQbrain_867; macaque brain D708I2V02HQ639 sequence
agtgccagaagagtgactg

SEQ ID NO: 12025 - DNA, 19 bp, Artificial
  MQbrain_868; macaque brain D708ZXV02H5QM8 sequence
gctgatggcaagggcactg

SEQ ID NO: 12026 - DNA, 20 bp, Artificial
  MQbrain_869; macaque brain D708ZXV02FL4HO sequence
ggagccaggagaggagtctg

SEQ ID NO: 12027 - DNA, 20 bp, Artificial
  MQbrain_869; macaque brain D708ZXV02HLE4R sequence
ctggagccaggagaggagtc

SEQ ID NO: 12028 - DNA, 21 bp, Artificial
  MQbrain_869; macaque brain D708ZXV02JY36X sequence
ggagccaggagaggagtctgc

SEQ ID NO: 12029 - DNA, 21 bp, Artificial
  MQbrain_86; macaque brain D4HK8WR01BH3EW sequence
acctgtgggtgactgaggttg

SEQ ID NO: 12030 - DNA, 22 bp, Artificial
  MQbrain_870; macaque brain D708YRU02HDNS0 sequence
aaatgagctggatggctgcagt

SEQ ID NO: 12031 - DNA, 22 bp, Artificial
  MQbrain_871; macaque brain D708YRU02HUMZV sequence
gtgatgaggttgttccctgtgt

SEQ ID NO: 12032 - DNA, 21 bp, Artificial
  MQbrain_872; macaque brain D4HK4YF01B5CH1 sequence
gatatggtgaggatgtcatgg

SEQ ID NO: 12033 - DNA, 22 bp, Artificial
  MQbrain_873; macaque brain D708I2V01DD53C sequence
acccggattggcgctgaggtgg

SEQ ID NO: 12034 - DNA, 26 bp, Artificial
  MQbrain_874; macaque brain D708YRU01CTGFH sequence
ggggagtagtagcagctctgcagagg

SEQ ID NO: 12035 - DNA, 21 bp, Artificial
  MQbrain_875; macaque brain D4HK8WR01BLIXW sequence
tgtgctgtgtgtgctgggtgc

SEQ ID NO: 12036 - DNA, 20 bp, Artificial
  MQbrain_876; macaque brain D708ZXV01ETFX6 sequence
atttcctgggaatgtgcctt

SEQ ID NO: 12037 - DNA, 22 bp, Artificial
  MQbrain_877; macaque brain D4HK8WR01COZV3 sequence
actgaggagaggggctaagatg

SEQ ID NO: 12038 - DNA, 21 bp, Artificial
  MQbrain_878; macaque brain D4HK8WR01E4YHK sequence
gtgggaggcagggccatgctg

SEQ ID NO: 12039 - DNA, 22 bp, Artificial
  MQbrain_879; macaque brain D4HK4YF02JS8H6 sequence
agaggcaaagagaggccatccc

SEQ ID NO: 12040 - DNA, 21 bp, Artificial
  MQbrain_87; macaque brain D4HK8WR01EM0YL sequence
caccagctatgcacagccacc

SEQ ID NO: 12041 - DNA, 22 bp, Artificial
  MQbrain_880; macaque brain D708YRU01DSMRG sequence
gcttgctgaaaggtgaaatgtg

SEQ ID NO: 12042 - DNA, 22 bp, Artificial
  MQbrain_881; macaque brain D4HK8WR02FZ2J8 sequence
agctgcagaggaggccttgtgg

SEQ ID NO: 12043 - DNA, 22 bp, Artificial
  MQbrain_882; macaque brain D708YRU02HBQ6K sequence
atggtggccgccatccccttcg

SEQ ID NO: 12044 - DNA, 20 bp, Artificial
  MQbrain_883; macaque brain D4HK8WR02HHIP9 sequence
gtgcctggaggatgttttgg

SEQ ID NO: 12045 - DNA, 20 bp, Artificial
  MQbrain_884; macaque brain D708YRU01AKMAQ sequence
aggaggagcagtggtctgtg

SEQ ID NO: 12046 - DNA, 18 bp, Artificial
  MQbrain_885; macaque brain D708YRU02HS2UE sequence
agcggcttccaagggacc

SEQ ID NO: 12047 - DNA, 20 bp, Artificial
  MQbrain_886; macaque brain D708ZXV01AJL9W sequence
cgtgggttcaggcaggtggc

SEQ ID NO: 12048 - DNA, 21 bp, Artificial
  MQbrain_887; macaque brain D4HK8WR01EI509 sequence
agctatggggtacatgctgtt

SEQ ID NO: 12049 - DNA, 19 bp, Artificial
  MQbrain_888; macaque brain D708YRU01CK1FN sequence
aagaaagagttacaaaggc

SEQ ID NO: 12050 - DNA, 19 bp, Artificial
  MQbrain_890; macaque brain D708YRU01EL4GP sequence
agggtctccgggtcttgtg

SEQ ID NO: 12051 - DNA, 21 bp, Artificial
  MQbrain_891; macaque brain D708YRU01ET5FL sequence
tgacggtggtgacagcagtgg

SEQ ID NO: 12052 - DNA, 21 bp, Artificial
  MQbrain_892; macaque brain D4HK8WR02JOCHW sequence
aagctagaagcagctggaggg

SEQ ID NO: 12053 - DNA, 22 bp, Artificial
  MQbrain_893; macaque brain D4HK4YF02IZLG3 sequence
gatctctcttgtgtggcttccg

SEQ ID NO: 12054 - DNA, 19 bp, Artificial
  MQbrain_894; macaque brain D708YRU01DI6HL sequence
ggtgagggggaggaccgcg

SEQ ID NO: 12055 - DNA, 22 bp, Artificial
  MQbrain_896; macaque brain D708YRU02IVAH0 sequence
tggtttctgtgggtgatgattc

SEQ ID NO: 12056 - DNA, 24 bp, Artificial
  MQbrain_897; macaque brain D708ZXV02H3UTW sequence
ctggccatggcctgtgctctgtcg

SEQ ID NO: 12057 - DNA, 22 bp, Artificial
  MQbrain_89; macaque brain D4HK8WR01ASE7E sequence
acgcagtgcaagtcccgcagtc

SEQ ID NO: 12058 - DNA, 23 bp, Artificial
  MQbrain_8; macaque brain D4G3X1F01CYOZG sequence
gaaagacggccagggccatccgg

SEQ ID NO: 12059 - DNA, 23 bp, Artificial
  MQbrain_900; macaque brain D708YRU02JGW1P sequence
ggtggaggtggcaagatgagacg

SEQ ID NO: 12060 - DNA, 20 bp, Artificial
  MQbrain_901; macaque brain D708I2V02I7UQ5 sequence
tgcaggtggtggtcgtgcgg

SEQ ID NO: 12061 - DNA, 22 bp, Artificial
  MQbrain_902; macaque brain D708YRU01B1A72 sequence
tgggagagaagacctggggatc

SEQ ID NO: 12062 - DNA, 20 bp, Artificial
  MQbrain_903; macaque brain D708I2V02G1D0R sequence
tgagagtggctgggtggtgc

SEQ ID NO: 12063 - DNA, 22 bp, Artificial
  MQbrain_904; macaque brain D708I2V02JBJEG sequence
gggaaaagtgactgcgattctg

SEQ ID NO: 12064 - DNA, 22 bp, Artificial
  MQbrain_905; macaque brain D4HK8WR02JIPRO sequence
ccaggggccaggttccactctg

SEQ ID NO: 12065 - DNA, 19 bp, Artificial
  MQbrain_906; macaque brain D708YRU02IMX9R sequence
ctcgggaagctcacagtct

SEQ ID NO: 12066 - DNA, 22 bp, Artificial
  MQbrain_908; macaque brain D708YRU01CYHDH sequence
atttagggaaagccactgaagg

SEQ ID NO: 12067 - DNA, 21 bp, Artificial
  MQbrain_909; macaque brain D708YRU02JF2JH sequence
tgaggaaatgagctgaagtgt

SEQ ID NO: 12068 - DNA, 21 bp, Artificial
  MQbrain_90; macaque brain D708YRU01DE83V sequence
gaggagtggtggattgggatg

SEQ ID NO: 12069 - DNA, 22 bp, Artificial
  MQbrain_911; macaque brain D4HK8WR02IZKS5 sequence
atgtgggtgatggggaagttgg

SEQ ID NO: 12070 - DNA, 23 bp, Artificial
  MQbrain_912; macaque brain D4HK4YF02JMI85 sequence
agctgagggcagacccagtttgg

SEQ ID NO: 12071 - DNA, 19 bp, Artificial
  MQbrain_913; macaque brain D708ZXV02IQBST sequence
agttgggaagtgagctgtt

SEQ ID NO: 12072 - DNA, 23 bp, Artificial
  MQbrain_914; macaque brain D4HK8WR01EFG20 sequence
tgccctgtgctccttcctgttcc

SEQ ID NO: 12073 - DNA, 21 bp, Artificial
  MQbrain_915; macaque brain D708I2V02FMER8 sequence
ctggcagagacctgggacttc

SEQ ID NO: 12074 - DNA, 21 bp, Artificial
  MQbrain_917; macaque brain D708I2V02F5X27 sequence
gcctggctgcagctctgtctc

SEQ ID NO: 12075 - DNA, 21 bp, Artificial
  MQbrain_918; macaque brain D4HK8WR02HASD2 sequence
ctctggacggagcccgggtgg

SEQ ID NO: 12076 - DNA, 21 bp, Artificial
  MQbrain_91; macaque brain D4HK8WR02HI4ZA sequence
gccaccgtgagggtcagcatc

SEQ ID NO: 12077 - DNA, 24 bp, Artificial
  MQbrain_920; macaque brain D4HK8WR02F6D4G sequence
agtttgaccggctgagggccttcc

SEQ ID NO: 12078 - DNA, 20 bp, Artificial
  MQbrain_921; macaque brain D4HK8WR02ILGBF sequence
tctcgccggggccgaggagg

SEQ ID NO: 12079 - DNA, 23 bp, Artificial
  MQbrain_922; macaque brain D708ZXV01EZJ2Z sequence
aatgaggaatgggagactgcatc

SEQ ID NO: 12080 - DNA, 19 bp, Artificial
  MQbrain_923; macaque brain D708ZXV01D848J sequence
ccggcagttccaggggatg

SEQ ID NO: 12081 - DNA, 18 bp, Artificial
  MQbrain_924; macaque brain D708I2V01EAH4G sequence
gtggggaggatgcttctg

SEQ ID NO: 12082 - DNA, 23 bp, Artificial
  MQbrain_924; macaque brain D708YRU02GKXV8 sequence
ccactgtggggaggatgcttctg

SEQ ID NO: 12083 - DNA, 21 bp, Artificial
  MQbrain_925; macaque brain D4G3X1F01ETUQL sequence
tgggcaggggcttattgtagg

SEQ ID NO: 12084 - DNA, 20 bp, Artificial
  MQbrain_926; macaque brain D708I2V01AVJJJ sequence
ggggcctccctgtgggtgtc

SEQ ID NO: 12085 - DNA, 22 bp, Artificial
  MQbrain_927; macaque brain D4G3X1F02IQG8E, macaque brain D708YRU02ISALJ sequence
caggccagatggggcaggaagg

SEQ ID NO: 12086 - DNA, 22 bp, Artificial
  MQbrain_928; macaque brain D708ZXV01A5Z2O sequence
ttggtccagagaaggcagaagg

SEQ ID NO: 12087 - DNA, 22 bp, Artificial
  MQbrain_929; macaque brain D708YRU02IJWYK sequence
tctgagtgtgttttgactgggc

SEQ ID NO: 12088 - DNA, 23 bp, Artificial
  MQbrain_92; macaque brain D4HK4YF01C0WJL sequence
tttggatgggcctggtactggtg

SEQ ID NO: 12089 - DNA, 22 bp, Artificial
  MQbrain_92; macaque brain D4HK8WR01DBD0Q sequence
ttggatgggcctggtactggtg

SEQ ID NO: 12090 - DNA, 21 bp, Artificial
  MQbrain_931; macaque brain D708ZXV01DZYP2 sequence
gtagacagggccgcaggaagc

SEQ ID NO: 12091 - DNA, 22 bp, Artificial
  MQbrain_932; macaque brain D708ZXV02GX2DK sequence
cctgcctgtctgtgcccagctg

SEQ ID NO: 12092 - DNA, 24 bp, Artificial
  MQbrain_933; macaque brain D708YRU02HUWMF sequence
agctgctggaggacagggacctgg

SEQ ID NO: 12093 - DNA, 23 bp, Artificial
  MQbrain_934; macaque brain D708I2V02JB2QL sequence
ctgatgagttgggcttagctttg

SEQ ID NO: 12094 - DNA, 20 bp, Artificial
  MQbrain_935; macaque brain D4HK8WR01DGXY7 sequence
gcccgagtcacccaaattgg

SEQ ID NO: 12095 - DNA, 19 bp, Artificial
  MQbrain_936; macaque brain D4HK8WR01C0ATB sequence
ggagagagtggctgggccc

SEQ ID NO: 12096 - DNA, 19 bp, Artificial
  MQbrain_937; macaque brain D4HK8WR02HC0UG sequence
tggccacaggaggctgctg

SEQ ID NO: 12097 - DNA, 22 bp, Artificial
  MQbrain_938; macaque brain D708YRU01DHEW7 sequence
acggcgccccggagcgagcctg

SEQ ID NO: 12098 - DNA, 22 bp, Artificial
  MQbrain_939; macaque brain D708YRU02GBB0M sequence
ctgggagagacgcttggcatgg

SEQ ID NO: 12099 - DNA, 19 bp, Artificial
  MQbrain_93; macaque brain D708YRU01CO11E sequence
cttttgggactggcctttg

SEQ ID NO: 12100 - DNA, 24 bp, Artificial
  MQbrain_940; macaque brain D4HK4YF01A6XH8 sequence
gctggccttggtggatgggatggc

SEQ ID NO: 12101 - DNA, 23 bp, Artificial
  MQbrain_940; macaque brain D4HK4YF02JC2SH sequence
ggccttggtggatgggatggctg

SEQ ID NO: 12102 - DNA, 24 bp, Artificial
  MQbrain_941; macaque brain D708I2V01CYQT5 sequence
gttggggaagatgggaggttgtgg

SEQ ID NO: 12103 - DNA, 23 bp, Artificial
  MQbrain_942; macaque brain D708ZXV02I1E7H sequence
gatgccactgtagccagatctcc

SEQ ID NO: 12104 - DNA, 21 bp, Artificial
  MQbrain_943; macaque brain D708ZXV02FJ1UR sequence
tgtgggggaagaggagagagg

SEQ ID NO: 12105 - DNA, 23 bp, Artificial
  MQbrain_944; macaque brain D708YRU02JQFJO sequence
ttgctcatggctccctcctgtcc

SEQ ID NO: 12106 - DNA, 20 bp, Artificial
  MQbrain_945; macaque brain D4HK8WR02I281J sequence
acaagcctctctggttggtc

SEQ ID NO: 12107 - DNA, 23 bp, Artificial
  MQbrain_946; macaque brain D708I2V02G18RI sequence
gtagacgctgatgcagctgatgc

SEQ ID NO: 12108 - DNA, 20 bp, Artificial
  MQbrain_948; macaque brain D4HK4YF02ILI0L, macaque brain D708ZXV02FJQ2K sequence
tgcagccttgtcttggcctc

SEQ ID NO: 12109 - DNA, 24 bp, Artificial
  MQbrain_948; macaque brain D708YRU01BAZWQ sequence
tgcagccttgtcttggcctcaagt

SEQ ID NO: 12110 - DNA, 21 bp, Artificial
  MQbrain_949; macaque brain D708ZXV02IBVC5 sequence
gagctcttggtcctccctgtc

SEQ ID NO: 12111 - DNA, 22 bp, Artificial
  MQbrain_950; macaque brain D708YRU01DQRW1 sequence
ggattggagtgagaatgacatc

SEQ ID NO: 12112 - DNA, 20 bp, Artificial
  MQbrain_951; macaque brain D708ZXV02JKUTP sequence
gtggactttggtcagtgagc

SEQ ID NO: 12113 - DNA, 19 bp, Artificial
  MQbrain_953; macaque brain D708YRU02GULAS sequence
agggagaggagatggcagg

SEQ ID NO: 12114 - DNA, 18 bp, Artificial
  MQbrain_954; macaque brain D4HK8WR01CSD88 sequence
tgtgtctccgttgcttgg

SEQ ID NO: 12115 - DNA, 24 bp, Artificial
  MQbrain_955; macaque brain D4HK8WR01BZ3WW sequence
ttttcttaccaagtgtgtgagctg

SEQ ID NO: 12116 - DNA, 22 bp, Artificial
  MQbrain_956; macaque brain D4HK8WR01CGOH5 sequence
tgtgatgtactttggccactgg

SEQ ID NO: 12117 - DNA, 25 bp, Artificial
  MQbrain_957; macaque brain D4G3X1F02H07NT sequence
atccactgaatatgcttttgccttt

SEQ ID NO: 12118 - DNA, 20 bp, Artificial
  MQbrain_958; macaque brain D708I2V01CGZLZ sequence
tggaggaaggaaagggttgg

SEQ ID NO: 12119 - DNA, 21 bp, Artificial
  MQbrain_95; macaque brain D708YRU01AST5G sequence
ggggcagcagagctggattgg

SEQ ID NO: 12120 - DNA, 20 bp, Artificial
  MQbrain_960; macaque brain D708ZXV01DX7B7 sequence
agagagaggggaagagaggg

SEQ ID NO: 12121 - DNA, 22 bp, Artificial
  MQbrain_961; macaque brain D708I2V01E504Z sequence
gtttctgtgacctagttccctc

SEQ ID NO: 12122 - DNA, 21 bp, Artificial
  MQbrain_963; macaque brain D4HK8WR01A358T sequence
gtggatgaggctgtgtgtgtc

SEQ ID NO: 12123 - DNA, 22 bp, Artificial
  MQbrain_964; macaque brain D708YRU02FH7JW sequence
caactttggtatcgtggaagga

SEQ ID NO: 12124 - DNA, 21 bp, Artificial
  MQbrain_965; macaque brain D708I2V01CZ5UF sequence
gatgggtgtatccaggaggcc

SEQ ID NO: 12125 - DNA, 20 bp, Artificial
  MQbrain_967; macaque brain D708ZXV01DQFJV sequence
accccagggccagtggtctt

SEQ ID NO: 12126 - DNA, 18 bp, Artificial
  MQbrain_968; macaque brain D708I2V02F17U2 sequence
ggaccagggagcacgtgg

SEQ ID NO: 12127 - DNA, 21 bp, Artificial
  MQbrain_969; macaque brain D4HK8WR02INQRD sequence
tgccatgtgtaggagtctggg

SEQ ID NO: 12128 - DNA, 18 bp, Artificial
  MQbrain_96; macaque brain D708I2V01DBWUT sequence
tttgctgggcagctgacc

SEQ ID NO: 12129 - DNA, 24 bp, Artificial
  MQbrain_971; macaque brain D708I2V02INJBM sequence
ccgccttggtggccagagggcagg

SEQ ID NO: 12130 - DNA, 19 bp, Artificial
  MQbrain_974; macaque brain D708I2V02H68GV sequence
ggggaaggagaaggcagcg

SEQ ID NO: 12131 - DNA, 19 bp, Artificial
  MQbrain_975; macaque brain D708ZXV02FZX6Y sequence
ggtggctgaagtgattggt

SEQ ID NO: 12132 - DNA, 20 bp, Artificial
  MQbrain_976; macaque brain D708ZXV02JAXD5 sequence
tctgtgccaggcctgtttgt

SEQ ID NO: 12133 - DNA, 18 bp, Artificial
  MQbrain_977; macaque brain D4HK8WR01EV5ZA sequence
ctatgtgggcactgaacg

SEQ ID NO: 12134 - DNA, 17 bp, Artificial
  MQbrain_978; macaque brain D4HK8WR02JDG3B sequence
aaatgaaactggggatt

SEQ ID NO: 12135 - DNA, 18 bp, Artificial
  MQbrain_979; macaque brain D708I2V02JTDYI sequence
ttgcccgttgctgctatg

SEQ ID NO: 12136 - DNA, 23 bp, Artificial
  MQbrain_97; macaque brain D4HK8WR02JRDUZ sequence
gctgccagaaccgagtccttgtc

SEQ ID NO: 12137 - DNA, 18 bp, Artificial
  MQbrain_980; macaque brain D708I2V02I61H1 sequence
agatgcccagagagagtc

SEQ ID NO: 12138 - DNA, 22 bp, Artificial
  MQbrain_981; macaque brain D4G3X1F01DG7JZ sequence
tggggtgtgcatggtgtgtgtc

SEQ ID NO: 12139 - DNA, 23 bp, Artificial
  MQbrain_981; macaque brain D708YRU02HOUJL sequence
tggggtgtgcatggtgtgtgtcg

SEQ ID NO: 12140 - DNA, 24 bp, Artificial
  MQbrain_982; macaque brain D4HK8WR01AP67T sequence
ggctatggtcagggaagatgaagg

SEQ ID NO: 12141 - DNA, 21 bp, Artificial
  MQbrain_983,MQbrain_2429,MQbrain_2463; macaque brain D4HK8WR02HK44L sequence
aagtggaggtaactggcgatg

SEQ ID NO: 12142 - DNA, 22 bp, Artificial
  MQbrain_984; macaque brain D708ZXV01BA48L sequence
tgtcctggtgcagcgtgtctgg

SEQ ID NO: 12143 - DNA, 18 bp, Artificial
  MQbrain_985; macaque brain D708ZXV02GQSZV sequence
gctggtggctggtgggtg

SEQ ID NO: 12144 - DNA, 21 bp, Artificial
  MQbrain_986; macaque brain D708I2V01CB813 sequence
gaatgcttggagtgtcttttc

SEQ ID NO: 12145 - DNA, 20 bp, Artificial
  MQbrain_987; macaque brain D708ZXV01E1RE1 sequence
cgccttcagccaagccgtct

SEQ ID NO: 12146 - DNA, 23 bp, Artificial
  MQbrain_988; macaque brain D4HK8WR01A9DOW sequence
ctgcagcagcactgcctggcgcc

SEQ ID NO: 12147 - DNA, 19 bp, Artificial
  MQbrain_98; macaque brain D4G3X1F02JTHYC sequence
ggaattgggactggctgcc

SEQ ID NO: 12148 - DNA, 23 bp, Artificial
  MQbrain_98; macaque brain D708I2V02JES05 sequence
ttgggactggctgccacaaagct

SEQ ID NO: 12149 - DNA, 22 bp, Artificial
  MQbrain_990; macaque brain D4HK8WR01EB0UW sequence
ttggggaagaggtgcgggaacg

SEQ ID NO: 12150 - DNA, 20 bp, Artificial
  MQbrain_991; macaque brain D708I2V02H3DLH sequence
gaaagagctggcctacgttc

SEQ ID NO: 12151 - DNA, 18 bp, Artificial
  MQbrain_993; macaque brain D708YRU01D9OP0 sequence
aaaatgggagtggagtgg

SEQ ID NO: 12152 - DNA, 18 bp, Artificial
  MQbrain_994; macaque brain D708ZXV01BU5KO sequence
agttcccaactgctgagt

SEQ ID NO: 12153 - DNA, 21 bp, Artificial
  MQbrain_995; macaque brain D708ZXV02HRGWV sequence
agaccattgaagccaacgggc

SEQ ID NO: 12154 - DNA, 22 bp, Artificial
  MQbrain_996; macaque brain D708YRU01B08G6 sequence
aagggtggaggaggaggctggg

SEQ ID NO: 12155 - DNA, 19 bp, Artificial
  MQbrain_997; macaque brain D4G3X1F02IYITX sequence
aagcatctggatggctggg

SEQ ID NO: 12156 - DNA, 27 bp, Artificial
  MQbrain_998; macaque brain D708ZXV01D56SZ sequence
tggcagacttgcccatggcccagaagc

SEQ ID NO: 12157 - DNA, 19 bp, Artificial
  MQbrain_999; macaque brain D4HK4YF02H462S sequence
catcctgccccaccccacc

SEQ ID NO: 12158 - DNA, 20 bp, Artificial
  MQbrain_99; macaque brain D708I2V01BCDED sequence
cctctgctgcttgccaagtt

SEQ ID NO: 12159 - DNA, 18 bp, Artificial
  MQbrain_9; macaque brain D708YRU02J0ZNA sequence
gctggctgctgtgtgagg

SEQ ID NO: 12160 - DNA, 19 bp, Artificial
  PT_101; chimp brain 174032 sequence
ctcggtccctacccccctc

SEQ ID NO: 12161 - DNA, 21 bp, Artificial
  PT_101; chimp brain 82646 sequence
tcggtccctacccccctccgg

SEQ ID NO: 12162 - DNA, 23 bp, Artificial
  PT_102; chimp brain 54754 sequence
tgacctcctcctccttcaagctc

SEQ ID NO: 12163 - DNA, 20 bp, Artificial
  PT_103; chimp brain 181175 sequence
gtctggctgttgtggtgtgc

SEQ ID NO: 12164 - DNA, 19 bp, Artificial
  PT_104; chimp brain 21127 sequence
gccgcggcttgggctccgc

SEQ ID NO: 12165 - DNA, 21 bp, Artificial
  PT_105; chimp brain 4916 sequence
tgactgtgctctgtcccccca

SEQ ID NO: 12166 - DNA, 20 bp, Artificial
  PT_108; chimp brain 211159 sequence
gacaggttctcttagctcac

SEQ ID NO: 12167 - DNA, 21 bp, Artificial
  PT_110; chimp brain 62645 sequence
aagaccaagacggactctctg

SEQ ID NO: 12168 - DNA, 18 bp, Artificial
  PT_112; chimp brain 128719 sequence
ggaagggggtctggcggg

SEQ ID NO: 12169 - DNA, 22 bp, Artificial
  PT_113; chimp brain 47194 sequence
tggggagggtccccagctgctt

SEQ ID NO: 12170 - DNA, 20 bp, Artificial
  PT_114; chimp brain 21692 sequence
taagccagtttctgtctgat

SEQ ID NO: 12171 - DNA, 19 bp, Artificial
  PT_114; chimp brain 45725 sequence
ctaagccagtttctgtctg

SEQ ID NO: 12172 - DNA, 18 bp, Artificial
  PT_114; chimp brain 94216 sequence
taagccagtttctgtctg

SEQ ID NO: 12173 - DNA, 23 bp, Artificial
  PT_115; chimp brain 131164 sequence
ggacgcaagaggtggccaggtgg

SEQ ID NO: 12174 - DNA, 22 bp, Artificial
  PT_117; chimp brain 131597 sequence
tcaggatcaggatctgcagagt

SEQ ID NO: 12175 - DNA, 21 bp, Artificial
  PT_117; chimp brain 33566 sequence
tcaggatcaggatctgcagag

SEQ ID NO: 12176 - DNA, 23 bp, Artificial
  PT_118; chimp brain 74742 sequence
tccacatggaagtgatgccgctc

SEQ ID NO: 12177 - DNA, 18 bp, Artificial
  PT_11; chimp brain 17954 sequence
gagaagggaggagttggc

SEQ ID NO: 12178 - DNA, 21 bp, Artificial
  PT_121; chimp brain 56619 sequence
agcagggccactcggaatctg

SEQ ID NO: 12179 - DNA, 19 bp, Artificial
  PT_122; chimp brain 197286 sequence
ggagctgatgctgcagatg

SEQ ID NO: 12180 - DNA, 18 bp, Artificial
  PT_123; chimp brain 12312 sequence
aatgggagccctccagac

SEQ ID NO: 12181 - DNA, 21 bp, Artificial
  PT_125; chimp brain 121486 sequence
ttctgaccctggccgtgaagt

SEQ ID NO: 12182 - DNA, 19 bp, Artificial
  PT_125; chimp brain 9789 sequence
ttctgaccctggccgtgaa

SEQ ID NO: 12183 - DNA, 20 bp, Artificial
  PT_126; chimp brain 173795 sequence
tgcaggaccaagatgagccc

SEQ ID NO: 12184 - DNA, 22 bp, Artificial
  PT_128; chimp brain 42973 sequence
ctctgagcaagctggcaaacag

SEQ ID NO: 12185 - DNA, 22 bp, Artificial
  PT_130; chimp brain 54916 sequence
gagcactgctttagagcctctg

SEQ ID NO: 12186 - DNA, 23 bp, Artificial
  PT_134; chimp brain 52303 sequence
ctacctcctgcccttcccaccgc

SEQ ID NO: 12187 - DNA, 21 bp, Artificial
  PT_135; chimp brain 78216 sequence
gaattgggaggaatgaccgtc

SEQ ID NO: 12188 - DNA, 22 bp, Artificial
  PT_136; chimp brain 201590 sequence
ttccagattgccgcagacctag

SEQ ID NO: 12189 - DNA, 19 bp, Artificial
  PT_136; chimp brain 34689 sequence
ttccagattgccgcagacc

SEQ ID NO: 12190 - DNA, 23 bp, Artificial
  PT_136; chimp brain 86714 sequence
ttccagattgccgcagacctagt

SEQ ID NO: 12191 - DNA, 21 bp, Artificial
  PT_138; chimp brain 66338 sequence
ttctgcctctgagtgtgtcag

SEQ ID NO: 12192 - DNA, 22 bp, Artificial
  PT_139; chimp brain 15561 sequence
ttggggcctccaccctctgtgt

SEQ ID NO: 12193 - DNA, 22 bp, Artificial
  PT_13; chimp brain 51121 sequence
atcggacccatttaaaccggag

SEQ ID NO: 12194 - DNA, 21 bp, Artificial
  PT_140; chimp brain 137639 sequence
ttcccagtgggcggctgtgtt

SEQ ID NO: 12195 - DNA, 19 bp, Artificial
  PT_141; chimp brain 207115 sequence
ttatgataatcataattta

SEQ ID NO: 12196 - DNA, 21 bp, Artificial
  PT_143; chimp brain 213105 sequence
tgaactttgaggctgaatgtc

SEQ ID NO: 12197 - DNA, 22 bp, Artificial
  PT_146; chimp brain 115453 sequence
acccttgagcctgatccctagc

SEQ ID NO: 12198 - DNA, 21 bp, Artificial
  PT_146; chimp brain 49720 sequence
acccttgagcctgatccctag

SEQ ID NO: 12199 - DNA, 21 bp, Artificial
  PT_147; chimp brain 115662 sequence
tggatatcttcaacacagcta

SEQ ID NO: 12200 - DNA, 23 bp, Artificial
  PT_148; chimp brain 164046 sequence
tgcttttccagacctgggacccg

SEQ ID NO: 12201 - DNA, 23 bp, Artificial
  PT_149, PT_150; chimp brain 172612 sequence
atggatgtcattgaacataatgg

SEQ ID NO: 12202 - DNA, 23 bp, Artificial
  PT_14; chimp brain 213314 sequence
agggtggacaccttggtcagaga

SEQ ID NO: 12203 - DNA, 22 bp, Artificial
  PT_151; chimp brain 211855 sequence
atgcctctgatcagtccatgac

SEQ ID NO: 12204 - DNA, 19 bp, Artificial
  PT_153; chimp brain 38204 sequence
tagcaccattttggaaatc

SEQ ID NO: 12205 - DNA, 20 bp, Artificial
  PT_154; chimp brain 26817 sequence
tacaacagatgagacatacc

SEQ ID NO: 12206 - DNA, 18 bp, Artificial
  PT_154; chimp brain 56000 sequence
tacaacagatgagacata

SEQ ID NO: 12207 - DNA, 19 bp, Artificial
  PT_155; chimp brain 129053 sequence
ctcatgctgcggcacggtt

SEQ ID NO: 12208 - DNA, 19 bp, Artificial
  PT_156, PT_22; chimp brain 54902 sequence
tgaagaggctatcatggag

SEQ ID NO: 12209 - DNA, 27 bp, Artificial
  PT_157; chimp brain 130954 sequence
ggatagggaggcctgaaacccagaatc

SEQ ID NO: 12210 - DNA, 24 bp, Artificial
  PT_157; chimp brain 38196 sequence
ggatagggaggcctgaaacccaga

SEQ ID NO: 12211 - DNA, 21 bp, Artificial
  PT_158; chimp brain 129676 sequence
taccttgccctctccctctag

SEQ ID NO: 12212 - DNA, 20 bp, Artificial
  PT_158; chimp brain 168079 sequence
taccttgccctctccctcta

SEQ ID NO: 12213 - DNA, 18 bp, Artificial
  PT_158; chimp brain 24859 sequence
taccttgccctctccctc

SEQ ID NO: 12214 - DNA, 21 bp, Artificial
  PT_161, PT_235, PT_262, PT_280; chimp brain 118286 sequence
aaaggccaaactgggaactct

SEQ ID NO: 12215 - DNA, 18 bp, Artificial
  PT_162; chimp brain 114876 sequence
aagtaagggtacagaatg

SEQ ID NO: 12216 - DNA, 20 bp, Artificial
  PT_163; chimp brain 102940 sequence
agggcttggctggagagatg

SEQ ID NO: 12217 - DNA, 23 bp, Artificial
  PT_165; chimp brain 111223 sequence
tttaattttaaggtatgtttcct

SEQ ID NO: 12218 - DNA, 22 bp, Artificial
  PT_168; chimp brain 29398 sequence
tgtgactggacctctggtcctc

SEQ ID NO: 12219 - DNA, 19 bp, Artificial
  PT_170; chimp brain 8703 sequence
tggtgggagagctggtgaa

SEQ ID NO: 12220 - DNA, 20 bp, Artificial
  PT_172; chimp brain 26118 sequence
cataacagatgtcactatgg

SEQ ID NO: 12221 - DNA, 18 bp, Artificial
  PT_173; chimp brain 106467 sequence
ccgcgccctctcatctcc

SEQ ID NO: 12222 - DNA, 22 bp, Artificial
  PT_174; chimp brain 182950 sequence
ttgttatccaaatcctggtttt

SEQ ID NO: 12223 - DNA, 22 bp, Artificial
  PT_176; chimp brain 121236 sequence
ccggggctgcgcgaggcacagg

SEQ ID NO: 12224 - DNA, 20 bp, Artificial
  PT_176; chimp brain 153590 sequence
ccggggctgcgcgaggcaca

SEQ ID NO: 12225 - DNA, 19 bp, Artificial
  PT_176; chimp brain 204432 sequence
ccggggctgcgcgaggcac

SEQ ID NO: 12226 - DNA, 22 bp, Artificial
  PT_177; chimp brain 82482 sequence
tctaacagcccagggtcctgct

SEQ ID NO: 12227 - DNA, 21 bp, Artificial
  PT_178; chimp brain 159181 sequence
tgagggatggcgcggaagtcg

SEQ ID NO: 12228 - DNA, 22 bp, Artificial
  PT_180; chimp brain 103689 sequence
agggcaagactgggccactttc

SEQ ID NO: 12229 - DNA, 21 bp, Artificial
  PT_182; chimp brain 24103 sequence
atgctgagtggaacattctct

SEQ ID NO: 12230 - DNA, 22 bp, Artificial
  PT_185; chimp brain 92820 sequence
gacctgtatcccaacctggctg

SEQ ID NO: 12231 - DNA, 25 bp, Artificial
  PT_187; chimp brain 67171 sequence
tgagatggttgtggtcagttgcacc

SEQ ID NO: 12232 - DNA, 22 bp, Artificial
  PT_18; chimp brain 114035 sequence
gcagaaggttcggatagagggg

SEQ ID NO: 12233 - DNA, 25 bp, Artificial
  PT_190; chimp brain 130087 sequence
ggtgagaacgtgcgcctgtgttgag

SEQ ID NO: 12234 - DNA, 21 bp, Artificial
  PT_191; chimp brain 92103 sequence
tggggaggctccacccagaag

SEQ ID NO: 12235 - DNA, 21 bp, Artificial
  PT_193; chimp brain 136842 sequence
cgaattaccacgccccctcct

SEQ ID NO: 12236 - DNA, 18 bp, Artificial
  PT_194; chimp brain 191873 sequence
gctggccccagctcctct

SEQ ID NO: 12237 - DNA, 18 bp, Artificial
  PT_195; chimp brain 216975 sequence
tgcgtgtggggccggcac

SEQ ID NO: 12238 - DNA, 24 bp, Artificial
  PT_196; chimp brain 164424 sequence
aacatccattgtttgggggttttt

SEQ ID NO: 12239 - DNA, 20 bp, Artificial
  PT_197; chimp brain 113844 sequence
cgctttgctgcccttcccag

SEQ ID NO: 12240 - DNA, 21 bp, Artificial
  PT_197; chimp brain 205029 sequence
cgctttgctgcccttcccaga

SEQ ID NO: 12241 - DNA, 19 bp, Artificial
  PT_199; chimp brain 60236 sequence
caggctggagcacagatgg

SEQ ID NO: 12242 - DNA, 21 bp, Artificial
  PT_1; chimp brain 122910 sequence
gacaagccagtgaccgtggtg

SEQ ID NO: 12243 - DNA, 21 bp, Artificial
  PT_201; chimp brain 171415 sequence
tcagagtcaacggacagagtt

SEQ ID NO: 12244 - DNA, 20 bp, Artificial
  PT_203; chimp brain 183286 sequence
tggaattgttgcctttcttg

SEQ ID NO: 12245 - DNA, 21 bp, Artificial
  PT_204; chimp brain 44676 sequence
ctgcctagtggggtggtagtg

SEQ ID NO: 12246 - DNA, 19 bp, Artificial
  PT_205; chimp brain 154401 sequence
ttgcaaaggacaagcagag

SEQ ID NO: 12247 - DNA, 21 bp, Artificial
  PT_206; chimp brain 92950 sequence
ttttttgctggaacatttctg

SEQ ID NO: 12248 - DNA, 20 bp, Artificial
  PT_207; chimp brain 179055 sequence
gcccggagagctgggagcca

SEQ ID NO: 12249 - DNA, 19 bp, Artificial
  PT_208; chimp brain 182839 sequence
tgtccacatggcctgcctc

SEQ ID NO: 12250 - DNA, 24 bp, Artificial
  PT_20; chimp brain 18605 sequence
agtgggcagttggtactggggagg

SEQ ID NO: 12251 - DNA, 23 bp, Artificial
  PT_211; chimp brain 132887 sequence
tgtgtgccaagctcagtcacctc

SEQ ID NO: 12252 - DNA, 22 bp, Artificial
  PT_214; chimp brain 165601 sequence
accaggctgtcaaggccccaac

SEQ ID NO: 12253 - DNA, 21 bp, Artificial
  PT_216, PT_217, PT_35; chimp brain 216089 sequence
tctgagtccccgcctcgcggg

SEQ ID NO: 12254 - DNA, 20 bp, Artificial
  PT_218; chimp brain 134192 sequence
taatggaattcctggccttg

SEQ ID NO: 12255 - DNA, 24 bp, Artificial
  PT_219, PT_220; chimp brain 78402 sequence
gtgagagcgcagcgtgggtgcagc

SEQ ID NO: 12256 - DNA, 22 bp, Artificial
  PT_21; chimp brain 129732 sequence
cctggcatcttgtccatggcaa

SEQ ID NO: 12257 - DNA, 19 bp, Artificial
  PT_221; chimp brain 12708 sequence
gctggttgacatggccccc

SEQ ID NO: 12258 - DNA, 22 bp, Artificial
  PT_222; chimp brain 178820 sequence
ctgagcacatccctgtcacctt

SEQ ID NO: 12259 - DNA, 24 bp, Artificial
  PT_224; chimp brain 27791 sequence
tctgggcagactaagtactctgtg

SEQ ID NO: 12260 - DNA, 23 bp, Artificial
  PT_226; chimp brain 93000 sequence
tagcccccaggcttcacttggcg

SEQ ID NO: 12261 - DNA, 21 bp, Artificial
  PT_228; chimp brain 76258 sequence
ttcttgcttccctttctccag

SEQ ID NO: 12262 - DNA, 21 bp, Artificial
  PT_229; chimp brain 212791 sequence
caggggtgagaggtcaggaga

SEQ ID NO: 12263 - DNA, 18 bp, Artificial
  PT_234; chimp brain 66128 sequence
cactagattgtgagcatc

SEQ ID NO: 12264 - DNA, 20 bp, Artificial
  PT_237; chimp brain 146984 sequence
tcggctgcgcccggagggga

SEQ ID NO: 12265 - DNA, 19 bp, Artificial
  PT_237; chimp brain 98403 sequence
tcggctgcgcccggagggg

SEQ ID NO: 12266 - DNA, 18 bp, Artificial
  PT_238; chimp brain 129980 sequence
gggtgtgggggagaaggg

SEQ ID NO: 12267 - DNA, 18 bp, Artificial
  PT_242; chimp brain 25858 sequence
gttcacagtggctaaagt

SEQ ID NO: 12268 - DNA, 19 bp, Artificial
  PT_243; chimp brain 126219 sequence
ctaacggtctcctgacctc

SEQ ID NO: 12269 - DNA, 18 bp, Artificial
  PT_244; chimp brain 188605 sequence
cttgtgagggaggggctg

SEQ ID NO: 12270 - DNA, 18 bp, Artificial
  PT_246; chimp brain 207481 sequence
tggctcagttcagcagaa

SEQ ID NO: 12271 - DNA, 22 bp, Artificial
  PT_247; chimp brain 122937 sequence
aacacagatgagtaacatgtaa

SEQ ID NO: 12272 - DNA, 22 bp, Artificial
  PT_248; chimp brain 100451 sequence
gaggccctggactcccacccag

SEQ ID NO: 12273 - DNA, 20 bp, Artificial
  PT_248; chimp brain 184065 sequence
gaggccctggactcccaccc

SEQ ID NO: 12274 - DNA, 22 bp, Artificial
  PT_250; chimp brain 120233 sequence
gtgcccagtgtctctcccaggc

SEQ ID NO: 12275 - DNA, 20 bp, Artificial
  PT_251; chimp brain 185226 sequence
gggccctggctgtaggcagc

SEQ ID NO: 12276 - DNA, 22 bp, Artificial
  PT_251; chimp brain 198063 sequence
gggccctggctgtaggcagctg

SEQ ID NO: 12277 - DNA, 18 bp, Artificial
  PT_253; chimp brain 71437 sequence
tagtgctctccattacaa

SEQ ID NO: 12278 - DNA, 18 bp, Artificial
  PT_254; chimp brain 70213 sequence
cttctcacaatactgcaa

SEQ ID NO: 12279 - DNA, 20 bp, Artificial
  PT_255; chimp brain 201055 sequence
aaaggactgtttccactggg

SEQ ID NO: 12280 - DNA, 18 bp, Artificial
  PT_256; chimp brain 126947 sequence
ctgttcagtcctcctgac

SEQ ID NO: 12281 - DNA, 18 bp, Artificial
  PT_257; chimp brain 175805 sequence
taacatgaaatctacaag

SEQ ID NO: 12282 - DNA, 18 bp, Artificial
  PT_258; chimp brain 125088 sequence
ctgaggggagctgggctg

SEQ ID NO: 12283 - DNA, 19 bp, Artificial
  PT_265,PT_267, PT_266, PT_55, PT_58, PT_59, PT_76; chimp brain 136565 sequence
tgtgcatttctctcccttc

SEQ ID NO: 12284 - DNA, 20 bp, Artificial
  PT_265,PT_267, PT_266, PT_55, PT_58, PT_59, PT_76; chimp brain 78285 sequence
tgtgcatttctctcccttct

SEQ ID NO: 12285 - DNA, 18 bp, Artificial
  PT_268; chimp brain 182098 sequence
ctgatggtgaagttaaat

SEQ ID NO: 12286 - DNA, 21 bp, Artificial
  PT_269; chimp brain 196621 sequence
cctgaccctgctcttgctctc

SEQ ID NO: 12287 - DNA, 22 bp, Artificial
  PT_26; chimp brain 14226 sequence
cgaccctgttcttctctgcgcg

SEQ ID NO: 12288 - DNA, 22 bp, Artificial
  PT_271; chimp brain 138806 sequence
gtgaagccccttccactggtag

SEQ ID NO: 12289 - DNA, 22 bp, Artificial
  PT_272; chimp brain 152647 sequence
ctctcagcccaggccacacctc

SEQ ID NO: 12290 - DNA, 18 bp, Artificial
  PT_27; chimp brain 106661 sequence
ggagaagcccaaggaggg

SEQ ID NO: 12291 - DNA, 18 bp, Artificial
  PT_281; chimp brain 140424 sequence
ttcattcggctgtccaga

SEQ ID NO: 12292 - DNA, 23 bp, Artificial
  PT_281; chimp brain 2279 sequence
ttcattcggctgtccagatgtat

SEQ ID NO: 12293 - DNA, 20 bp, Artificial
  PT_281; chimp brain 42902 sequence
tcattcggctgtccagatgt

SEQ ID NO: 12294 - DNA, 18 bp, Artificial
  PT_282; chimp brain 94617 sequence
tgagtaccgccatgtctg

SEQ ID NO: 12295 - DNA, 19 bp, Artificial
  PT_283; chimp brain 98770 sequence
cccacctgtcctgcttctc

SEQ ID NO: 12296 - DNA, 22 bp, Artificial
  PT_284; chimp brain 128186 sequence
agaaaaggggtgactgtccctc

SEQ ID NO: 12297 - DNA, 21 bp, Artificial
  PT_285; chimp brain 80306 sequence
ctgacccggcccctcccgcag

SEQ ID NO: 12298 - DNA, 23 bp, Artificial
  PT_286; chimp brain 198493 sequence
agccgctcttctccctgcccaca

SEQ ID NO: 12299 - DNA, 21 bp, Artificial
  PT_287, PT_288; chimp brain 121559 sequence
tgctcactgtgtgcacaggcg

SEQ ID NO: 12300 - DNA, 19 bp, Artificial
  PT_287, PT_288; chimp brain 91713 sequence
tgctcactgtgtgcacagg

SEQ ID NO: 12301 - DNA, 22 bp, Artificial
  PT_289; chimp brain 212554 sequence
acacacctggaggcagacgaga

SEQ ID NO: 12302 - DNA, 24 bp, Artificial
  PT_28; chimp brain 98977 sequence
caccaccatggggtgaggcttggc

SEQ ID NO: 12303 - DNA, 25 bp, Artificial
  PT_290; chimp brain 204161 sequence
catgcgggtccccatcaacgacaac

SEQ ID NO: 12304 - DNA, 20 bp, Artificial
  PT_291; chimp brain 129110 sequence
gcagggcaaggtgaccattg

SEQ ID NO: 12305 - DNA, 21 bp, Artificial
  PT_292; chimp brain 209059 sequence
ttgggcggctgagagccccag

SEQ ID NO: 12306 - DNA, 21 bp, Artificial
  PT_294; chimp brain 119913 sequence
ggcctgggtcttggggactgg

SEQ ID NO: 12307 - DNA, 24 bp, Artificial
  PT_294; chimp brain 57734 sequence
ggcctgggtcttggggactggagg

SEQ ID NO: 12308 - DNA, 18 bp, Artificial
  PT_295; chimp brain 12964 sequence
gaggacagggaagtgtgc

SEQ ID NO: 12309 - DNA, 18 bp, Artificial
  PT_297; chimp brain 78092 sequence
tacttggaaaggcatcag

SEQ ID NO: 12310 - DNA, 18 bp, Artificial
  PT_299; chimp brain 182259 sequence
agaggcctgggagggact

SEQ ID NO: 12311 - DNA, 22 bp, Artificial
  PT_300; chimp brain 165381 sequence
ttaaagctcttctcccttccat

SEQ ID NO: 12312 - DNA, 23 bp, Artificial
  PT_301; chimp brain 172931 sequence
agcgtccaggtgtccagccaagt

SEQ ID NO: 12313 - DNA, 22 bp, Artificial
  PT_303; chimp brain 168870 sequence
ctcctggggcccgcactctcgc

SEQ ID NO: 12314 - DNA, 21 bp, Artificial
  PT_303; chimp brain 20162 sequence
ctcctggggcccgcactctcg

SEQ ID NO: 12315 - DNA, 23 bp, Artificial
  PT_303; chimp brain 206705 sequence
ctcctggggcccgcactctcgct

SEQ ID NO: 12316 - DNA, 22 bp, Artificial
  PT_305; chimp brain 145933 sequence
tgggagggcagggccaggcagg

SEQ ID NO: 12317 - DNA, 21 bp, Artificial
  PT_306; chimp brain 130805 sequence
tcaggcccctgtctgccccag

SEQ ID NO: 12318 - DNA, 22 bp, Artificial
  PT_308; chimp brain 57891 sequence
ctgcagcccccagctcaggctc

SEQ ID NO: 12319 - DNA, 20 bp, Artificial
  PT_309; chimp brain 9708 sequence
cgtgtccaccattaaagggg

SEQ ID NO: 12320 - DNA, 21 bp, Artificial
  PT_30; chimp brain 156231 sequence
accaggaggctgaggcccctc

SEQ ID NO: 12321 - DNA, 22 bp, Artificial
  PT_310; chimp brain 57586 sequence
ttgagttactttgccttatccc

SEQ ID NO: 12322 - DNA, 21 bp, Artificial
  PT_313; chimp brain 207414 sequence
tccggttctcagggctccacc

SEQ ID NO: 12323 - DNA, 20 bp, Artificial
  PT_313; chimp brain 49724 sequence
tccggttctcagggctccac

SEQ ID NO: 12324 - DNA, 22 bp, Artificial
  PT_314; chimp brain 207989 sequence
tggggagctgaggctctggggg

SEQ ID NO: 12325 - DNA, 18 bp, Artificial
  PT_315; chimp brain 90166 sequence
cgttaggtcaaggtgtag

SEQ ID NO: 12326 - DNA, 22 bp, Artificial
  PT_317; chimp brain 141880 sequence
acccaggaccagtctgcccagg

SEQ ID NO: 12327 - DNA, 23 bp, Artificial
  PT_317; chimp brain 175986 sequence
aaggcggactgtcttagagtggt

SEQ ID NO: 12328 - DNA, 19 bp, Artificial
  PT_317; chimp brain 205025 sequence
acccaggaccagtctgccc

SEQ ID NO: 12329 - DNA, 21 bp, Artificial
  PT_317; chimp brain 32455 sequence
aaggcggactgtcttagagtg

SEQ ID NO: 12330 - DNA, 22 bp, Artificial
  PT_319; chimp brain 49037 sequence
ggccctcgaccggaccggtgcg

SEQ ID NO: 12331 - DNA, 23 bp, Artificial
  PT_319; chimp brain 69627 sequence
ggccctcgaccggaccggtgcgc

SEQ ID NO: 12332 - DNA, 22 bp, Artificial
  PT_31; chimp brain 56139 sequence
tctcctgcacagtgctcctgct

SEQ ID NO: 12333 - DNA, 20 bp, Artificial
  PT_320; chimp brain 62131 sequence
tgaaagctgggtgtccttgc

SEQ ID NO: 12334 - DNA, 18 bp, Artificial
  PT_321; chimp brain 143140 sequence
ctcattgcatgggctgtg

SEQ ID NO: 12335 - DNA, 21 bp, Artificial
  PT_323; chimp brain 175952 sequence
gggagaaggaggtggcctgga

SEQ ID NO: 12336 - DNA, 20 bp, Artificial
  PT_323; chimp brain 1951 sequence
gggagaaggaggtggcctgg

SEQ ID NO: 12337 - DNA, 21 bp, Artificial
  PT_325; chimp brain 132651 sequence
ccctgcctgttttctcctttg

SEQ ID NO: 12338 - DNA, 22 bp, Artificial
  PT_325; chimp brain 212515 sequence
ccctgcctgttttctcctttgt

SEQ ID NO: 12339 - DNA, 22 bp, Artificial
  PT_325; chimp brain 25718 sequence
gccctgcctgttttctcctttg

SEQ ID NO: 12340 - DNA, 20 bp, Artificial
  PT_325; chimp brain 42866 sequence
aggaggaaataggcaggcca

SEQ ID NO: 12341 - DNA, 24 bp, Artificial
  PT_326; chimp brain 130135 sequence
tccagtaccacgtgtcagggccac

SEQ ID NO: 12342 - DNA, 19 bp, Artificial
  PT_328; chimp brain 119772 sequence
catatgtctgctgaccatc

SEQ ID NO: 12343 - DNA, 18 bp, Artificial
  PT_328; chimp brain 172334 sequence
tatgtctgctgaccatca

SEQ ID NO: 12344 - DNA, 21 bp, Artificial
  PT_328; chimp brain 204558 sequence
tggtgggccgcagaacatgtg

SEQ ID NO: 12345 - DNA, 22 bp, Artificial
  PT_328; chimp brain 24132 sequence
tggtgggccgcagaacatgtgc

SEQ ID NO: 12346 - DNA, 22 bp, Artificial
  PT_328; chimp brain 98592 sequence
tatgtctgctgaccatcacctt

SEQ ID NO: 12347 - DNA, 21 bp, Artificial
  PT_329, PT_330; chimp brain 189770 sequence
agaggataccctttgtatgtt

SEQ ID NO: 12348 - DNA, 21 bp, Artificial
  PT_329; chimp brain 118525 sequence
atatacagggggagactctta

SEQ ID NO: 12349 - DNA, 22 bp, Artificial
  PT_329; chimp brain 51290 sequence
atatacagggggagactcttat

SEQ ID NO: 12350 - DNA, 22 bp, Artificial
  PT_32; chimp brain 126417 sequence
attaatatcggacaaccattgt

SEQ ID NO: 12351 - DNA, 20 bp, Artificial
  PT_330; chimp brain 78187 sequence
tatacagggggagactctca

SEQ ID NO: 12352 - DNA, 19 bp, Artificial
  PT_331, PT_332; chimp brain 122252 sequence
agggtctcagcctcggccg

SEQ ID NO: 12353 - DNA, 24 bp, Artificial
  PT_333; chimp brain 139004 sequence
gatcttcatgccctgggttctgcc

SEQ ID NO: 12354 - DNA, 21 bp, Artificial
  PT_333; chimp brain 45322 sequence
tgaaagctgccatggccctgg

SEQ ID NO: 12355 - DNA, 23 bp, Artificial
  PT_333; chimp brain 76879 sequence
tgaaagctgccatggccctggag

SEQ ID NO: 12356 - DNA, 20 bp, Artificial
  PT_334; chimp brain 110260 sequence
agtgcaatattgcttatagg

SEQ ID NO: 12357 - DNA, 19 bp, Artificial
  PT_334; chimp brain 182382 sequence
tagtgcaatattgcttata

SEQ ID NO: 12358 - DNA, 21 bp, Artificial
  PT_334; chimp brain 30730 sequence
accctatcaatattgtctctg

SEQ ID NO: 12359 - DNA, 24 bp, Artificial
  PT_335; chimp brain 182744 sequence
tgcggcctcctctcctaacctcgc

SEQ ID NO: 12360 - DNA, 21 bp, Artificial
  PT_336; chimp brain 132068 sequence
atccccagatacaacggacaa

SEQ ID NO: 12361 - DNA, 20 bp, Artificial
  PT_339; chimp brain 23587 sequence
ttcctctgatgacttcctgt

SEQ ID NO: 12362 - DNA, 19 bp, Artificial
  PT_339; chimp brain 45097 sequence
ttcctctgatgacttcctg

SEQ ID NO: 12363 - DNA, 21 bp, Artificial
  PT_339; chimp brain 52270 sequence
ttcctctgatgacttcctgtt

SEQ ID NO: 12364 - DNA, 21 bp, Artificial
  PT_340; chimp brain 207804 sequence
gtacatgatgacaactggctc

SEQ ID NO: 12365 - DNA, 23 bp, Artificial
  PT_340; chimp brain 39750 sequence
gtacatgatgacaactggctccc

SEQ ID NO: 12366 - DNA, 23 bp, Artificial
  PT_340; chimp brain 57562 sequence
ctgctatgaggaaactgccatgt

SEQ ID NO: 12367 - DNA, 22 bp, Artificial
  PT_340; chimp brain 85762 sequence
gtacatgatgacaactggctcc

SEQ ID NO: 12368 - DNA, 22 bp, Artificial
  PT_34; chimp brain 87526 sequence
cccgcctatcgccctccaaact

SEQ ID NO: 12369 - DNA, 24 bp, Artificial
  PT_37; chimp brain 26704 sequence
ttgagatctcccgccgtcctgacc

SEQ ID NO: 12370 - DNA, 20 bp, Artificial
  PT_38; chimp brain 156630 sequence
ccagcttggttgctttcttg

SEQ ID NO: 12371 - DNA, 20 bp, Artificial
  PT_3; chimp brain 105161 sequence
gagtttggaggagggaccaa

SEQ ID NO: 12372 - DNA, 21 bp, Artificial
  PT_40; chimp brain 203456 sequence
tctgtttacaacacacccaac

SEQ ID NO: 12373 - DNA, 18 bp, Artificial
  PT_41; chimp brain 127956 sequence
ccctccccacgccgcctc

SEQ ID NO: 12374 - DNA, 19 bp, Artificial
  PT_41; chimp brain 15025 sequence
cccctccccacgccgcctc

SEQ ID NO: 12375 - DNA, 22 bp, Artificial
  PT_43; chimp brain 7280 sequence
cctctgggcctctgactcacac

SEQ ID NO: 12376 - DNA, 18 bp, Artificial
  PT_44; chimp brain 58560 sequence
gagctctcgctggaccct

SEQ ID NO: 12377 - DNA, 21 bp, Artificial
  PT_48; chimp brain 216979 sequence
agaagcattctttcattggtt

SEQ ID NO: 12378 - DNA, 22 bp, Artificial
  PT_48; chimp brain 4541 sequence
agaagcattctttcattggttg

SEQ ID NO: 12379 - DNA, 20 bp, Artificial
  PT_4; chimp brain 67453 sequence
ccactatgcttagccctaaa

SEQ ID NO: 12380 - DNA, 18 bp, Artificial
  PT_50; chimp brain 29713 sequence
tctttgttatctagctgt

SEQ ID NO: 12381 - DNA, 21 bp, Artificial
  PT_53; chimp brain 50980 sequence
ggccctgccgaggcatcagct

SEQ ID NO: 12382 - DNA, 21 bp, Artificial
  PT_54; chimp brain 120989 sequence
tggaggatccccaggtggcat

SEQ ID NO: 12383 - DNA, 19 bp, Artificial
  PT_54; chimp brain 50201 sequence
tggaggatccccaggtggc

SEQ ID NO: 12384 - DNA, 21 bp, Artificial
  PT_56; chimp brain 18393 sequence
ttggttccagcgcagtctcca

SEQ ID NO: 12385 - DNA, 19 bp, Artificial
  PT_57; chimp brain 180206 sequence
tccaccctctcctcttcca

SEQ ID NO: 12386 - DNA, 24 bp, Artificial
  PT_60; chimp brain 125280 sequence
tcctctgtcctctccctttcccag

SEQ ID NO: 12387 - DNA, 22 bp, Artificial
  PT_60; chimp brain 168113 sequence
ctcctctgtcctctccctttcc

SEQ ID NO: 12388 - DNA, 20 bp, Artificial
  PT_61; chimp brain 138756 sequence
tggtcactgctgagggactg

SEQ ID NO: 12389 - DNA, 21 bp, Artificial
  PT_61; chimp brain 17418 sequence
tggtcactgctgagggactgc

SEQ ID NO: 12390 - DNA, 19 bp, Artificial
  PT_63; chimp brain 47816 sequence
caaagggagatctctgtgg

SEQ ID NO: 12391 - DNA, 21 bp, Artificial
  PT_64; chimp brain 141696 sequence
tctcagcctctattccctggc

SEQ ID NO: 12392 - DNA, 18 bp, Artificial
  PT_66; chimp brain 45954 sequence
gccatcaaggccctgggg

SEQ ID NO: 12393 - DNA, 21 bp, Artificial
  PT_70; chimp brain 82210 sequence
ccgtggccttgggggcaggag

SEQ ID NO: 12394 - DNA, 19 bp, Artificial
  PT_71; chimp brain 131296 sequence
tgaaggaggtggggccttg

SEQ ID NO: 12395 - DNA, 25 bp, Artificial
  PT_72; chimp brain 70594 sequence
ttgttagaaatcgcctctgaagatc

SEQ ID NO: 12396 - DNA, 19 bp, Artificial
  PT_73; chimp brain 147289 sequence
tgagacaggcttatgctgc

SEQ ID NO: 12397 - DNA, 21 bp, Artificial
  PT_74; chimp brain 10117 sequence
tttagtacgtgtggcttggtc

SEQ ID NO: 12398 - DNA, 20 bp, Artificial
  PT_7; chimp brain 114953 sequence
gactcgactcgtgtgcggac

SEQ ID NO: 12399 - DNA, 20 bp, Artificial
  PT_7; chimp brain 195797 sequence
ggactcgactcgtgtgcgga

SEQ ID NO: 12400 - DNA, 23 bp, Artificial
  PT_7; chimp brain 3229 sequence
aggactcgactcgtgtgcggaca

SEQ ID NO: 12401 - DNA, 22 bp, Artificial
  PT_7; chimp brain 33448 sequence
ggactcgactcgtgtgcggaca

SEQ ID NO: 12402 - DNA, 23 bp, Artificial
  PT_81; chimp brain 39644 sequence
ctgaccaggcatgggcctagggg

SEQ ID NO: 12403 - DNA, 20 bp, Artificial
  PT_83; chimp brain 154318 sequence
tccccaacccctgcccgcag

SEQ ID NO: 12404 - DNA, 19 bp, Artificial
  PT_84; chimp brain 69912 sequence
cacctggtttgatgccatc

SEQ ID NO: 12405 - DNA, 22 bp, Artificial
  PT_86; chimp brain 124081 sequence
actccaaatccagaagtcagag

SEQ ID NO: 12406 - DNA, 20 bp, Artificial
  PT_89; chimp brain 43358 sequence
tctctgtcccccctacccca

SEQ ID NO: 12407 - DNA, 19 bp, Artificial
  PT_91; chimp brain 5873 sequence
gagggaggagccgctggtg

SEQ ID NO: 12408 - DNA, 22 bp, Artificial
  PT_92; chimp brain 69582 sequence
tccctctgtgctcacctcccag

SEQ ID NO: 12409 - DNA, 20 bp, Artificial
  PT_93; chimp brain 71865 sequence
ctagccaggccctcccgcca

SEQ ID NO: 12410 - DNA, 21 bp, Artificial
  PT_94; chimp brain 49929 sequence
tgccctgcatggtgtccccac

SEQ ID NO: 12411 - DNA, 19 bp, Artificial
  PT_95; chimp brain 127499 sequence
cagcccctcgtcctctgcc

SEQ ID NO: 12412 - DNA, 19 bp, Artificial
  PT_99; chimp brain 56944 sequence
tgcaccctttctttcccag

SEQ ID NO: 12413 - DNA, 8 bp, Artificial
  5' spacer
cgatcttt

SEQ ID NO: 12414 - DNA, 31 bp, Artificial
  3' spacer
tagggtccgataagggtcagtgctcgctcta

SEQ ID NO: 12415 - RNA, 22 nt, Artificial
  miR-402
uucgaggccuauuaaaccucug

SEQ ID NO: 12416 - RNA, 22 nt, Artificial
  miR-418
uaaugugaugaugaacugaccu

SEQ ID NO: 12417 - RNA, 22 nt, Artificial
  miR-167
ugaagcugccagcaugaucugg

SEQ ID NO: 12418 - RNA, 22 nt, Artificial
  miR-416
gguucguacguacacuguucau

SEQ ID NO: 12419 - RNA, 22 nt, Artificial
  miR-173
uucgcuugcagagagaaaucac

SEQ ID NO: 12420 - RNA, 22 nt, Artificial
  miR-417
gaagguagugaauuuguucgac

SEQ ID NO: 12421 - RNA, 22 nt, Artificial
  miR-163
gaagaggacuuggaacuucgau

SEQ ID NO: 12422 - RNA, 22 nt, Artificial
  miR-419
uuaugaaugcugaggauguugu

SEQ ID NO: 12423 - RNA, 22 nt, Artificial
  miR-405
gaguugggucuaacccauaacu

SEQ ID NO: 12424 - RNA, 22 nt, Artificial
  miR-420
uaaacuaaucacggaaaugcac

SEQ ID NO: 12425 - DNA, 18 bp, Artificial
  M13forward
tgtaaaacgacggccagt

SEQ ID NO: 12426 - DNA, 19 bp, Artificial
  M13reverse
aggaaacagctatgaccat

SEQ ID NO: 12427 - DNA, 22 bp, Artificial
  M13forward
gtaatacgactcactatagggc

SEQ ID NO: 12428 - DNA, 22 bp, Artificial
  HSbrain_29; human brain D71F8O202IV7MS sequence
gctttgccctggttcctttgtg

SEQ ID NO: 12429 - DNA, 26 bp, Artificial
  HSbrain_46; human brain D71F8O202IQ3GR sequence
cttggggtcaagggacacgccttctg

SEQ ID NO: 12430 - DNA, 19 bp, Artificial
  HSbrain_412; human brain D71F8O201EPXKK sequence
gatggcacacctgagctgc

SEQ ID NO: 12431 - DNA, 18 bp, Artificial
  HSbrain_421; human brain D71F8O202GYK3F sequence
ggcgagcgggatgggggt

SEQ ID NO: 12432 - DNA, 26 bp, Artificial
  HSbrain_493; human brain D703HKJ02H2I72 sequence
tgaaggccaagtggaggtgactggtg

SEQ ID NO: 12433 - DNA, 19 bp, Artificial
  HSbrain_629; human brain D703HKJ02F1WWO sequence
ttctttctcctccatgccc

SEQ ID NO: 12434 - DNA, 21 bp, Artificial
  HSbrain_766; human brain D71F8O202FGMGS sequence
gtggccatggtgtgcaccagg

SEQ ID NO: 12435 - DNA, 18 bp, Artificial
  HSbrain_821; human brain D71F8O202FNPSI sequence
aaagctgggttgagaagg

SEQ ID NO: 12436 - DNA, 16 bp, Artificial
  HSbrain_821; human brain D4G3XZT02HJCEW sequence
agctgggttgagaagg

SEQ ID NO: 12437 - DNA, 25 bp, Artificial
  MQbrain_2520; macaque brain D4HK8WR02IQXSO sequence
atgtcactcggctcggcccactacc

SEQ ID NO: 12438 - DNA, 18 bp, Artificial
  HSbrain_1436, MQbrain_2602; human brain D703HKJ02G8WNK, macaque brain D708ZXV02G6IGS sequence
tcggctctgggtctgtgg

SEQ ID NO: 12439 - DNA, 18 bp, Artificial
  MQbrain_137; macaque brain D4HK4YF01DXVQY sequence
cggcggcggctgtggctg

SEQ ID NO: 12440 - DNA, 18 bp, Artificial
  MQbrain_206; macaque brain D708I2V02GL6NC sequence
gaggctggggctgcaccg

SEQ ID NO: 12441 - DNA, 21 bp, Artificial
  MQbrain_487; macaque brain D708YRU02I0W7G sequence
attgggggtggaaggctgggg

SEQ ID NO: 12442 - DNA, 21 bp, Artificial
  MQbrain_661; macaque brain D4HK8WR01AI31E sequence
gtgagtagtggcgcgcggcgg

SEQ ID NO: 12443 - DNA, 19 bp, Artificial
  MQbrain_798; macaque brain D4HK8WR01EEXGT sequence
agcaggaggctgatgaagg

SEQ ID NO: 12444 - DNA, 19 bp, Artificial
  MQbrain_865; macaque brain D4HK8WR02JMUU2 sequence
tgtgagctgcagggctggg

SEQ ID NO: 12445 - DNA, 21 bp, Artificial
  MQbrain_947; macaque brain D708I2V01E6SA4 sequence
ggaggagtggagggtccaggg

SEQ ID NO: 12446 - DNA, 18 bp, Artificial
  HSbrain_421; human brain D71F8O202GYK3F sequence
ggcgagcgggatgggggt

SEQ ID NO: 12447 - DNA, 100 bp, Artificial
  Hairpin sequence Mmd_1, dog
ggttgggcagggtgcggggctagggctaacagcagtcttactgagggtttcttggaaaccacacacatgctgttgccactaacctcaaccttactcggtc

SEQ ID NO: 12448 - DNA, 100 bp, Artificial
  Hairpin sequence Mmd_1, cow
ggttgggcggggtgcggggctagggctaacagcaggctcactgacggtttcccggaaaccacacacatgctgttgccactaacctcaaccttactcggtc

SEQ ID NO: 12449 - DNA, 18 bp, Artificial
  MQbrain_1074; macaque brain D708YRU02JUQCQ sequence
gtgggaaggggaggggtg

SEQ ID NO: 12450 - DNA, 23 bp, Artificial
  MQbrain_1391; macaque brain D708I2V02H4203 sequence
cctgctggcctgaggctcacctc

SEQ ID NO: 12451 - DNA, 19 bp, Artificial
  MQbrain_1409; macaque brain D708YRU02FWYCR sequence
tggggctgcccgggggtgg

SEQ ID NO: 12452 - DNA, 20 bp, Artificial
  MQbrain_1519; macaque brain D708ZXV02GCBBI sequence
agttgtgcagctttgagtcc
